United States Patent 8,222,221 (MODULATION OF GENE EXPRESSION THROUGH ENDOGENOUS SMALL RNA TARGETING OF GENE PROMOTERS) - sequence listing, part 2

SEQ ID NO: 39402 - RNA, 23 nt, Homo sapiens
gggagugaagacacggagccaga

SEQ ID NO: 39403 - RNA, 23 nt, Homo sapiens
aggaacagcagcagcccgggccg

SEQ ID NO: 39404 - RNA, 23 nt, Homo sapiens
aggaacagcagcagcccgggccg

SEQ ID NO: 39405 - RNA, 22 nt, Homo sapiens
acccuuaucaguucuccgucca

SEQ ID NO: 39406 - RNA, 21 nt, Homo sapiens
gaccaaucgccguccccgccg

SEQ ID NO: 39407 - RNA, 22 nt, Homo sapiens
ucagaccgagacaagugcaaug

SEQ ID NO: 39408 - RNA, 21 nt, Homo sapiens
acaggauugagggggggcccu

SEQ ID NO: 39409 - RNA, 22 nt, Homo sapiens
agcugaguguaggauguuuaca

SEQ ID NO: 39410 - RNA, 22 nt, Homo sapiens
cagcauggaguccuccagguug

SEQ ID NO: 39411 - RNA, 22 nt, Homo sapiens
ugcaagccuugggugugggagg

SEQ ID NO: 39412 - RNA, 22 nt, Homo sapiens
gcggucccgcggcgccccgccu

SEQ ID NO: 39413 - RNA, 22 nt, Homo sapiens
ugcuguuagcccuagccccgca

SEQ ID NO: 39414 - RNA, 22 nt, Homo sapiens
cacucuaaagggaggcacuuug

SEQ ID NO: 39415 - RNA, 22 nt, Homo sapiens
ggaggccgggacgagugcaaua

SEQ ID NO: 39416 - RNA, 23 nt, Homo sapiens
ucauagcccuguacaaugcugcu

SEQ ID NO: 39417 - RNA, 23 nt, Homo sapiens
ugauagcccuguacaaugcugcu

SEQ ID NO: 39418 - RNA, 20 nt, Homo sapiens
ggggggcgaggcagguguga

SEQ ID NO: 39419 - RNA, 22 nt, Homo sapiens
aggucucacuuuguugcccaga

SEQ ID NO: 39420 - RNA, 22 nt, Homo sapiens
cacaaaccauuaugugcugcua

SEQ ID NO: 39421 - RNA, 22 nt, Homo sapiens
uguaaaccaugaugugcugcua

SEQ ID NO: 39422 - RNA, 22 nt, Homo sapiens
cgccaauauuuacgugcugcua

SEQ ID NO: 39423 - RNA, 20 nt, Homo sapiens
cccgccgcgucgcccugggg

SEQ ID NO: 39424 - RNA, 21 nt, Homo sapiens
gccaauauuucugugcugcua

SEQ ID NO: 39425 - RNA, 25 nt, Homo sapiens
agcuagucaagcgcgguuguggggg

SEQ ID NO: 39426 - RNA, 23 nt, Homo sapiens
acaccaaugcccuaggggaugcg

SEQ ID NO: 39427 - RNA, 22 nt, Homo sapiens
uucaaaacaugaauugcugcug

SEQ ID NO: 39428 - RNA, 22 nt, Homo sapiens
gcugccguauaugugaugucac

SEQ ID NO: 39429 - RNA, 21 nt, Homo sapiens
acaaaccacagugugcugcug

SEQ ID NO: 39430 - RNA, 22 nt, Homo sapiens
agcacagacuugcugugauguu

SEQ ID NO: 39431 - RNA, 25 nt, Homo sapiens
aaggagcucagaagcccugcccagc

SEQ ID NO: 39432 - RNA, 22 nt, Homo sapiens
gauccgagcaccggggaccccc

SEQ ID NO: 39433 - RNA, 22 nt, Homo sapiens
cugcucaaacccuccaaugacu

SEQ ID NO: 39434 - RNA, 17 nt, Homo sapiens
uggaggccccagcgaga

SEQ ID NO: 39435 - RNA, 22 nt, Homo sapiens
gguuaguggaccaggucacaaa

SEQ ID NO: 39436 - RNA, 23 nt, Homo sapiens
agaaaccaugggguaugagcaga

SEQ ID NO: 39437 - RNA, 22 nt, Homo sapiens
uagcagaagcauuuccgcacac

SEQ ID NO: 39438 - RNA, 21 nt, Homo sapiens
gaccaaucgccguccccgccg

SEQ ID NO: 39439 - RNA, 22 nt, Homo sapiens
agcugaguguaggauguuuaca

SEQ ID NO: 39440 - RNA, 22 nt, Homo sapiens
acaaaaguugccuuugugugau

SEQ ID NO: 39441 - RNA, 21 nt, Homo sapiens
ggacuauagaacuuucccccu

SEQ ID NO: 39442 - RNA, 22 nt, Homo sapiens
gcggucccgcggcgccccgccu

SEQ ID NO: 39443 - RNA, 21 nt, Homo sapiens
caucaccuuccuucuccucca

SEQ ID NO: 39444 - RNA, 22 nt, Homo sapiens
cacucuaaagggaggcacuuug

SEQ ID NO: 39445 - RNA, 22 nt, Homo sapiens
ggcagagagucagagcgcggau

SEQ ID NO: 39446 - RNA, 22 nt, Homo sapiens
uagcagaagcauuuccgcacac

SEQ ID NO: 39447 - RNA, 23 nt, Homo sapiens
gggagugaagacacggagccaga

SEQ ID NO: 39448 - RNA, 21 nt, Homo sapiens
acuagacugugagcuccucga

SEQ ID NO: 39449 - RNA, 21 nt, Homo sapiens
gaccaaucgccguccccgccg

SEQ ID NO: 39450 - RNA, 22 nt, Homo sapiens
ucagaccgagacaagugcaaug

SEQ ID NO: 39451 - RNA, 20 nt, Homo sapiens
cuggaggaagggcccagagg

SEQ ID NO: 39452 - RNA, 22 nt, Homo sapiens
gccuaagacacaggcccagaga

SEQ ID NO: 39453 - RNA, 23 nt, Homo sapiens
cggcucugucgucgaggcgcuca

SEQ ID NO: 39454 - RNA, 22 nt, Homo sapiens
gcggucccgcggcgccccgccu

SEQ ID NO: 39455 - RNA, 22 nt, Homo sapiens
ugcuguuagcccuagccccgca

SEQ ID NO: 39456 - RNA, 17 nt, Homo sapiens
gacagccucucccccac

SEQ ID NO: 39457 - RNA, 23 nt, Homo sapiens
gggagugaagacacggagccaga

SEQ ID NO: 39458 - RNA, 24 nt, Homo sapiens
agugugaguucuaccauugccaaa

SEQ ID NO: 39459 - RNA, 22 nt, Homo sapiens
accagcuaacaauacacugcca

SEQ ID NO: 39460 - RNA, 22 nt, Homo sapiens
ccucauggaaggguuccccacu

SEQ ID NO: 39461 - RNA, 22 nt, Homo sapiens
gcaaaagaaacugugguuuuug

SEQ ID NO: 39462 - RNA, 21 nt, Homo sapiens
ucgacugccacucuuacuaga

SEQ ID NO: 39463 - RNA, 22 nt, Homo sapiens
caagacacauuuggagagggac

SEQ ID NO: 39464 - RNA, 23 nt, Homo sapiens
gacguaguccuauucucugcugc

SEQ ID NO: 39465 - RNA, 20 nt, Homo sapiens
uacugcuuccacagcucccc

SEQ ID NO: 39466 - RNA, 21 nt, Homo sapiens
acuccaaagggaagcgccuuc

SEQ ID NO: 39467 - RNA, 22 nt, Homo sapiens
ggaucccugggaccauaccuag

SEQ ID NO: 39468 - RNA, 23 nt, Homo sapiens
ccuucucagaaaggugaaauuua

SEQ ID NO: 39469 - RNA, 21 nt, Homo sapiens
guaaugggaccuuccucuuug

SEQ ID NO: 39470 - RNA, 21 nt, Homo sapiens
agacacaccacggcacacuuc

SEQ ID NO: 39471 - RNA, 22 nt, Homo sapiens
cacauggccaaaacagagaaga

SEQ ID NO: 39472 - RNA, 21 nt, Homo sapiens
cuggaggacggcaacagucag

SEQ ID NO: 39473 - RNA, 24 nt, Homo sapiens
acugcaggcuccagcuuccaggcu

SEQ ID NO: 39474 - RNA, 22 nt, Homo sapiens
ggcucccaagaaccucaccugu

SEQ ID NO: 39475 - RNA, 18 nt, Homo sapiens
uggcgccugaacagggac

SEQ ID NO: 39476 - RNA, 18 nt, Homo sapiens
aucacauucaccucccug

SEQ ID NO: 39477 - RNA, 22 nt, Homo sapiens
ccccucuggucaaccagucaca

SEQ ID NO: 39478 - RNA, 21 nt, Homo sapiens
cggggugcacgggcggagggc

SEQ ID NO: 39479 - RNA, 22 nt, Homo sapiens
acaaaguucugugaugcacuga

SEQ ID NO: 39480 - RNA, 23 nt, Homo sapiens
gggagugaagacacggagccaga

SEQ ID NO: 39481 - RNA, 22 nt, Homo sapiens
uggcagcagcggagggggcaga

SEQ ID NO: 39482 - RNA, 22 nt, Homo sapiens
cagaagugggccgggcacaggg

SEQ ID NO: 39483 - RNA, 22 nt, Homo sapiens
agucuucacaacagcccugugu

SEQ ID NO: 39484 - RNA, 22 nt, Homo sapiens
ucagaccgagacaagugcaaug

SEQ ID NO: 39485 - RNA, 20 nt, Homo sapiens
ccagcagcaccuggggcagu

SEQ ID NO: 39486 - RNA, 21 nt, Homo sapiens
ucaaucacagauagcaccccu

SEQ ID NO: 39487 - RNA, 23 nt, Homo sapiens
aaagucucgcucucugccccuca

SEQ ID NO: 39488 - RNA, 22 nt, Homo sapiens
aucgggaggggacugagccuga

SEQ ID NO: 39489 - RNA, 21 nt, Homo sapiens
auccuguacugagcugccccg

SEQ ID NO: 39490 - RNA, 22 nt, Homo sapiens
aagagggagacccaggcucgga

SEQ ID NO: 39491 - RNA, 25 nt, Homo sapiens
accaacggaccuacuucccuccgcc

SEQ ID NO: 39492 - RNA, 21 nt, Homo sapiens
cuggaggacggcaacagucag

SEQ ID NO: 39493 - RNA, 20 nt, Homo sapiens
cucaaagcaaacccugcaga

SEQ ID NO: 39494 - RNA, 25 nt, Homo sapiens
aagaaagagucuugcuuugucgccc

SEQ ID NO: 39495 - RNA, 17 nt, Homo sapiens
gggagaggaggaggcga

SEQ ID NO: 39496 - RNA, 21 nt, Homo sapiens
acuagacugugagcuccucga

SEQ ID NO: 39497 - RNA, 21 nt, Homo sapiens
gggcaucugggacgcgcagga

SEQ ID NO: 39498 - RNA, 23 nt, Homo sapiens
cuaccugcacuguaagcacuuug

SEQ ID NO: 39499 - RNA, 22 nt, Homo sapiens
cggugagcacccggccccugcg

SEQ ID NO: 39500 - RNA, 22 nt, Homo sapiens
caugauugccacgucugcagua

SEQ ID NO: 39501 - RNA, 21 nt, Homo sapiens
ugauugccacugucugcagua

SEQ ID NO: 39502 - RNA, 25 nt, Homo sapiens
acggagcugucccaacaccaccccu

SEQ ID NO: 39503 - RNA, 22 nt, Homo sapiens
aggucucacuuuguugcccaga

SEQ ID NO: 39504 - RNA, 23 nt, Homo sapiens
uccaucaucaaaacaaauggagu

SEQ ID NO: 39505 - RNA, 20 nt, Homo sapiens
cuggaggaagggcccagagg

SEQ ID NO: 39506 - RNA, 22 nt, Homo sapiens
gccuaagacacaggcccagaga

SEQ ID NO: 39507 - RNA, 22 nt, Homo sapiens
auaaggauuuuuaggggcauua

SEQ ID NO: 39508 - RNA, 25 nt, Homo sapiens
aaggagcucagaagcccugcccagc

SEQ ID NO: 39509 - RNA, 19 nt, Homo sapiens
gcucuaagaaagccacacu

SEQ ID NO: 39510 - RNA, 20 nt, Homo sapiens
uccccacagacccagagccg

SEQ ID NO: 39511 - RNA, 22 nt, Homo sapiens
caaacaccauugucacacucca

SEQ ID NO: 39512 - RNA, 21 nt, Homo sapiens
cggggugcacgggcggagggc

SEQ ID NO: 39513 - RNA, 23 nt, Homo sapiens
gggagugaagacacggagccaga

SEQ ID NO: 39514 - RNA, 22 nt, Homo sapiens
ucaggaacugccuuucucucca

SEQ ID NO: 39515 - RNA, 21 nt, Homo sapiens
gaccaaucgccguccccgccg

SEQ ID NO: 39516 - RNA, 22 nt, Homo sapiens
agcugaguguaggauguuuaca

SEQ ID NO: 39517 - RNA, 21 nt, Homo sapiens
cccgaggagccgggcaggcuu

SEQ ID NO: 39518 - RNA, 22 nt, Homo sapiens
caagacacauuuggagagggac

SEQ ID NO: 39519 - RNA, 25 nt, Homo sapiens
accaacggaccuacuucccuccgcc

SEQ ID NO: 39520 - RNA, 22 nt, Homo sapiens
gcggucccgcggcgccccgccu

SEQ ID NO: 39521 - RNA, 22 nt, Homo sapiens
ugcuguuagcccuagccccgca

SEQ ID NO: 39522 - RNA, 22 nt, Homo sapiens
ggcagagagucagagcgcggau

SEQ ID NO: 39523 - RNA, 24 nt, Homo sapiens
acugcuggucuucagucagggcca

SEQ ID NO: 39524 - RNA, 22 nt, Homo sapiens
augcccuuucaucauugcacug

SEQ ID NO: 39525 - RNA, 21 nt, Homo sapiens
cggggugcacgggcggagggc

SEQ ID NO: 39526 - RNA, 22 nt, Homo sapiens
acaaaguucuguagugcacuga

SEQ ID NO: 39527 - RNA, 22 nt, Homo sapiens
acaaaguucugugaugcacuga

SEQ ID NO: 39528 - RNA, 21 nt, Homo sapiens
ccaaguucugucaugcacuga

SEQ ID NO: 39529 - RNA, 18 nt, Homo sapiens
ggagaggagggcacugga

SEQ ID NO: 39530 - RNA, 22 nt, Homo sapiens
acugggacuuuguaggccaguu

SEQ ID NO: 39531 - RNA, 22 nt, Homo sapiens
agcgggacuuugagggccaguu

SEQ ID NO: 39532 - RNA, 22 nt, Homo sapiens
acggaagggcagagagggccag

SEQ ID NO: 39533 - RNA, 23 nt, Homo sapiens
ucucacccagguagcaaggauua

SEQ ID NO: 39534 - RNA, 22 nt, Homo sapiens
agaauccuugcccgggugcauu

SEQ ID NO: 39535 - RNA, 22 nt, Homo sapiens
ugaauccuugcccaggugcauu

SEQ ID NO: 39536 - RNA, 19 nt, Homo sapiens
auuuugguacagcagcuca

SEQ ID NO: 39537 - RNA, 20 nt, Homo sapiens
ugggccaccgccgagcggac

SEQ ID NO: 39538 - RNA, 21 nt, Homo sapiens
guaaugggaccuuccucuuug

SEQ ID NO: 39539 - RNA, 25 nt, Homo sapiens
accaacggaccuacuucccuccgcc

SEQ ID NO: 39540 - RNA, 21 nt, Homo sapiens
caucaccuuccuucuccucca

SEQ ID NO: 39541 - RNA, 22 nt, Homo sapiens
ggcagagagucagagcgcggau

SEQ ID NO: 39542 - RNA, 22 nt, Homo sapiens
ggaggccgggacgagugcaaua

SEQ ID NO: 39543 - RNA, 21 nt, Homo sapiens
ccccucccagccucccugcca

SEQ ID NO: 39544 - RNA, 22 nt, Homo sapiens
cuggagagacaaggggaagagg

SEQ ID NO: 39545 - RNA, 24 nt, Homo sapiens
gaaagugcauagaauucugucugg

SEQ ID NO: 39546 - RNA, 23 nt, Homo sapiens
cuaucugcacuagaugcaccuua

SEQ ID NO: 39547 - RNA, 22 nt, Homo sapiens
cggugagcacccggccccugcg

SEQ ID NO: 39548 - RNA, 23 nt, Homo sapiens
acauuuuucguuauugcucuuga

SEQ ID NO: 39549 - RNA, 22 nt, Homo sapiens
ccuggcacacaguagaccuuca

SEQ ID NO: 39550 - RNA, 23 nt, Homo sapiens
acagaaagugcuucccucaagag

SEQ ID NO: 39551 - RNA, 22 nt, Homo sapiens
gcacacaauaaauguuugcuga

SEQ ID NO: 39552 - RNA, 19 nt, Homo sapiens
gcuccuguccaacuggcuc

SEQ ID NO: 39553 - RNA, 22 nt, Homo sapiens
gauccgagcaccggggaccccc

SEQ ID NO: 39554 - RNA, 22 nt, Homo sapiens
gcugaggcuguggggcuggagu

SEQ ID NO: 39555 - RNA, 22 nt, Homo sapiens
ucuacccagaaaggagccagug

SEQ ID NO: 39556 - RNA, 21 nt, Homo sapiens
cuggaggacggcaacagucag

SEQ ID NO: 39557 - RNA, 22 nt, Homo sapiens
acaaaguucuguagugcacuga

SEQ ID NO: 39558 - RNA, 22 nt, Homo sapiens
acaaaguucugugaugcacuga

SEQ ID NO: 39559 - RNA, 22 nt, Homo sapiens
agccacaaucaccuucugaucu

SEQ ID NO: 39560 - RNA, 21 nt, Homo sapiens
acaaaccacagugugcugcug

SEQ ID NO: 39561 - RNA, 24 nt, Homo sapiens
cacccccagagccucagcucccca

SEQ ID NO: 39562 - RNA, 21 nt, Homo sapiens
ccccucccagccucccugcca

SEQ ID NO: 39563 - RNA, 22 nt, Homo sapiens
gugggguggguggucaggccga

SEQ ID NO: 39564 - RNA, 23 nt, Homo sapiens
aggaacagcagcagcccgggccg

SEQ ID NO: 39565 - RNA, 23 nt, Homo sapiens
cuaucugcacuagaugcaccuua

SEQ ID NO: 39566 - RNA, 21 nt, Homo sapiens
ugcaugacggccugcaagaca

SEQ ID NO: 39567 - RNA, 22 nt, Homo sapiens
guccaaaguuggggugcugguu

SEQ ID NO: 39568 - RNA, 20 nt, Homo sapiens
cccugcgccaucuccucuac

SEQ ID NO: 39569 - RNA, 23 nt, Homo sapiens
ucacauaggaauaaaaagccaua

SEQ ID NO: 39570 - RNA, 23 nt, Homo sapiens
ucacauaggaaugaaaagccaua

SEQ ID NO: 39571 - RNA, 21 nt, Homo sapiens
uagaaaggcuaggaccaaacc

SEQ ID NO: 39572 - RNA, 22 nt, Homo sapiens
auaaggauuuuuaggggcauua

SEQ ID NO: 39573 - RNA, 22 nt, Homo sapiens
cucagagcagacgugguucuca

SEQ ID NO: 39574 - RNA, 21 nt, Homo sapiens
agacacaccacggcacacuuc

SEQ ID NO: 39575 - RNA, 22 nt, Homo sapiens
gcaaaaguaauugcagugugug

SEQ ID NO: 39576 - RNA, 23 nt, Homo sapiens
agcagcauuguacagggcuauga

SEQ ID NO: 39577 - RNA, 21 nt, Homo sapiens
cucccccacugcagcuggcac

SEQ ID NO: 39578 - RNA, 22 nt, Homo sapiens
cgcauuauuacucacgguacga

SEQ ID NO: 39579 - RNA, 21 nt, Homo sapiens
ucacccagaucugcggccuaa

SEQ ID NO: 39580 - RNA, 22 nt, Homo sapiens
uuaacagcuaagcacccuaauc

SEQ ID NO: 39581 - RNA, 21 nt, Homo sapiens
aaagugucagauacggugugg

SEQ ID NO: 39582 - RNA, 23 nt, Homo sapiens
gcgcccaauuaaugucuguugau

SEQ ID NO: 39583 - RNA, 22 nt, Homo sapiens
aaucagucucauugcuuuauaa

SEQ ID NO: 39584 - RNA, 23 nt, Homo sapiens
aaucgcgguuuauaccaaaugaa

SEQ ID NO: 39585 - RNA, 20 nt, Homo sapiens
agagaugagagaaacacccu

SEQ ID NO: 39586 - RNA, 22 nt, Homo sapiens
ccucgggauggcgcccguucac

SEQ ID NO: 39587 - RNA, 21 nt, Homo sapiens
ugacugacagcuuuuugagua

SEQ ID NO: 39588 - RNA, 22 nt, Homo sapiens
agaaaaugccccucaguuuuga

SEQ ID NO: 39589 - RNA, 20 nt, Homo sapiens
cccgccgcgucgcccugggg

SEQ ID NO: 39590 - RNA, 20 nt, Homo sapiens
acauuacuguuaucaaaaca

SEQ ID NO: 39591 - RNA, 22 nt, Homo sapiens
acugccugucugugccugcugu

SEQ ID NO: 39592 - RNA, 21 nt, Homo sapiens
accuauccugaauuacuugaa

SEQ ID NO: 39593 - RNA, 22 nt, Homo sapiens
accagguuccaccccagcaggc

SEQ ID NO: 39594 - RNA, 22 nt, Homo sapiens
gauagagugcagaccagggucu

SEQ ID NO: 39595 - RNA, 18 nt, Homo sapiens
augacaccucccugugaa

SEQ ID NO: 39596 - RNA, 22 nt, Homo sapiens
gcaaaaguaauugccaguuuug

SEQ ID NO: 39597 - RNA, 22 nt, Homo sapiens
ugcaaaaguagucucaguuuuu

SEQ ID NO: 39598 - RNA, 19 nt, Homo sapiens
aaaaguaauuacaguuuuu

SEQ ID NO: 39599 - RNA, 22 nt, Homo sapiens
gcaaaaguaacugcaguuuugg

SEQ ID NO: 39600 - RNA, 22 nt, Homo sapiens
aaaguaacugcaguuuuugcua

SEQ ID NO: 39601 - RNA, 21 nt, Homo sapiens
uugucuaaccagucaccuguu

SEQ ID NO: 39602 - RNA, 23 nt, Homo sapiens
ucauagcccuguacaaugcugcu

SEQ ID NO: 39603 - RNA, 23 nt, Homo sapiens
ugauagcccuguacaaugcugcu

SEQ ID NO: 39604 - RNA, 22 nt, Homo sapiens
acccuuaucaguucuccgucca

SEQ ID NO: 39605 - RNA, 22 nt, Homo sapiens
ucaggaacugccuuucucucca

SEQ ID NO: 39606 - RNA, 21 nt, Homo sapiens
gaccaaucgccguccccgccg

SEQ ID NO: 39607 - RNA, 22 nt, Homo sapiens
aggcauaggaugacaaagggaa

SEQ ID NO: 39608 - RNA, 23 nt, Homo sapiens
cuaccugcacuaugagcacuuug

SEQ ID NO: 39609 - RNA, 22 nt, Homo sapiens
aggcgaaggaugacaaagggaa

SEQ ID NO: 39610 - RNA, 22 nt, Homo sapiens
ucaguuuccucugcaaacaguu

SEQ ID NO: 39611 - RNA, 22 nt, Homo sapiens
gcggucccgcggcgccccgccu

SEQ ID NO: 39612 - RNA, 22 nt, Homo sapiens
ugcuguuagcccuagccccgca

SEQ ID NO: 39613 - RNA, 21 nt, Homo sapiens
caucaccuuccuucuccucca

SEQ ID NO: 39614 - RNA, 21 nt, Homo sapiens
caucaccuuccuucuccucca

SEQ ID NO: 39615 - RNA, 21 nt, Homo sapiens
cacaaccucaguguuuccagg

SEQ ID NO: 39616 - RNA, 22 nt, Homo sapiens
uggcagcagcggagggggcaga

SEQ ID NO: 39617 - RNA, 20 nt, Homo sapiens
cccgccgcgucgcccugggg

SEQ ID NO: 39618 - RNA, 22 nt, Homo sapiens
ucagaccgagacaagugcaaug

SEQ ID NO: 39619 - RNA, 20 nt, Homo sapiens
ccagcagcaccuggggcagu

SEQ ID NO: 39620 - RNA, 21 nt, Homo sapiens
uucuaggauaggcccaggggc

SEQ ID NO: 39621 - RNA, 21 nt, Homo sapiens
auccuguacugagcugccccg

SEQ ID NO: 39622 - RNA, 19 nt, Homo sapiens
guugggaucacaggcgccc

SEQ ID NO: 39623 - RNA, 22 nt, Homo sapiens
ugcuguuagcccuagccccgca

SEQ ID NO: 39624 - RNA, 23 nt, Homo sapiens
gcacaugugcacacagccgggug

SEQ ID NO: 39625 - RNA, 22 nt, Homo sapiens
ggcaaaauccgcaauuacuuuu

SEQ ID NO: 39626 - RNA, 21 nt, Homo sapiens
aacggaaccacuagugacuug

SEQ ID NO: 39627 - RNA, 22 nt, Homo sapiens
accagcuaacaauacacugcca

SEQ ID NO: 39628 - RNA, 23 nt, Homo sapiens
gaaaaacgcccccuggcuugaaa

SEQ ID NO: 39629 - RNA, 22 nt, Homo sapiens
aggaaaccagcaaguguugacg

SEQ ID NO: 39630 - RNA, 22 nt, Homo sapiens
acacucuaaagggaaccauuuu

SEQ ID NO: 39631 - RNA, 23 nt, Homo sapiens
gacguaguccuauucucugcugc

SEQ ID NO: 39632 - RNA, 22 nt, Homo sapiens
cuggagagacaaggggaagagg

SEQ ID NO: 39633 - RNA, 21 nt, Homo sapiens
cugggggacggagcagaagga

SEQ ID NO: 39634 - RNA, 22 nt, Homo sapiens
uaaaugaauucaauuuccuucu

SEQ ID NO: 39635 - RNA, 21 nt, Homo sapiens
gagcuacagugcuucaucuca

SEQ ID NO: 39636 - RNA, 22 nt, Homo sapiens
uggcagcagcggagggggcaga

SEQ ID NO: 39637 - RNA, 22 nt, Homo sapiens
uagucaagugaagcagugggag

SEQ ID NO: 39638 - RNA, 22 nt, Homo sapiens
agccacaaucaccuucugaucu

SEQ ID NO: 39639 - RNA, 22 nt, Homo sapiens
agcugaguguaggauguuuaca

SEQ ID NO: 39640 - RNA, 20 nt, Homo sapiens
ccagcagcaccuggggcagu

SEQ ID NO: 39641 - RNA, 21 nt, Homo sapiens
auccuguacugagcugccccg

SEQ ID NO: 39642 - RNA, 21 nt, Homo sapiens
caucaccuuccuucuccucca

SEQ ID NO: 39643 - RNA, 23 nt, Homo sapiens
agaaaccaugggguaugagcaga

SEQ ID NO: 39644 - RNA, 22 nt, Homo sapiens
cacugguacaaggguugggaga

SEQ ID NO: 39645 - RNA, 22 nt, Homo sapiens
augcccuuuuaacauugcacug

SEQ ID NO: 39646 - RNA, 21 nt, Homo sapiens
ggaaaucccuggcaaugugau

SEQ ID NO: 39647 - RNA, 21 nt, Homo sapiens
gguaaucccuggcaaugugau

SEQ ID NO: 39648 - RNA, 20 nt, Homo sapiens
ggcauucaccgcgugccuua

SEQ ID NO: 39649 - RNA, 18 nt, Homo sapiens
ugguggcagaggugggau

SEQ ID NO: 39650 - RNA, 23 nt, Homo sapiens
ucacauaggaaugaaaagccaua

SEQ ID NO: 39651 - RNA, 22 nt, Homo sapiens
cagaagugggccgggcacaggg

SEQ ID NO: 39652 - RNA, 22 nt, Homo sapiens
ugagccacugugccuggccuga

SEQ ID NO: 39653 - RNA, 21 nt, Homo sapiens
acccaguagccagauguagcu

SEQ ID NO: 39654 - RNA, 22 nt, Homo sapiens
uaaccgauuucagauggugcua

SEQ ID NO: 39655 - RNA, 23 nt, Homo sapiens
aacacugauuucaaauggugcua

SEQ ID NO: 39656 - RNA, 22 nt, Homo sapiens
uaaccgauuucaaauggugcua

SEQ ID NO: 39657 - RNA, 21 nt, Homo sapiens
aucugcacugucagcacuuua

SEQ ID NO: 39658 - RNA, 23 nt, Homo sapiens
gcuuugacaauaucauugcacug

SEQ ID NO: 39659 - RNA, 23 nt, Homo sapiens
acgggugcgauuucugugugaga

SEQ ID NO: 39660 - RNA, 22 nt, Homo sapiens
acaaaaguugccuuugugugau

SEQ ID NO: 39661 - RNA, 22 nt, Homo sapiens
cagcauggaguccuccagguug

SEQ ID NO: 39662 - RNA, 21 nt, Homo sapiens
ucuacucagaagggugccuua

SEQ ID NO: 39663 - RNA, 22 nt, Homo sapiens
ugcaagccuugggugugggagg

SEQ ID NO: 39664 - RNA, 22 nt, Homo sapiens
acaaaagcaacugagguucuug

SEQ ID NO: 39665 - RNA, 23 nt, Homo sapiens
gggccgcagcugucgcccguguc

SEQ ID NO: 39666 - RNA, 24 nt, Homo sapiens
acgcgcaggccagagacccaggca

SEQ ID NO: 39667 - RNA, 20 nt, Homo sapiens
gcagaagcauuuccacacac

SEQ ID NO: 39668 - RNA, 22 nt, Homo sapiens
ucaguuuccucugcaaacaguu

SEQ ID NO: 39669 - RNA, 21 nt, Homo sapiens
gccaauauuucugugcugcua

SEQ ID NO: 39670 - RNA, 22 nt, Homo sapiens
cacuuaucagguuguauuauaa

SEQ ID NO: 39671 - RNA, 21 nt, Homo sapiens
ccuacguuccauagucuacca

SEQ ID NO: 39672 - RNA, 21 nt, Homo sapiens
cguacgcuauacggucuacua

SEQ ID NO: 39673 - RNA, 22 nt, Homo sapiens
ccuggcacacaguagaccuuca

SEQ ID NO: 39674 - RNA, 21 nt, Homo sapiens
ucccagcacacauuuagcuca

SEQ ID NO: 39675 - RNA, 21 nt, Homo sapiens
agguaauaccaauaccuugug

SEQ ID NO: 39676 - RNA, 20 nt, Homo sapiens
cccugcgccaucuccucuac

SEQ ID NO: 39677 - RNA, 21 nt, Homo sapiens
cggggugcacgggcggagggc

SEQ ID NO: 39678 - RNA, 21 nt, Homo sapiens
cggggugcacgggcggagggc

SEQ ID NO: 39679 - RNA, 21 nt, Homo sapiens
gaccaaucgccguccccgccg

SEQ ID NO: 39680 - RNA, 23 nt, Homo sapiens
aaagucucgcucucugccccuca

SEQ ID NO: 39681 - RNA, 25 nt, Homo sapiens
accaacggaccuacuucccuccgcc

SEQ ID NO: 39682 - RNA, 22 nt, Homo sapiens
gcggucccgcggcgccccgccu

SEQ ID NO: 39683 - RNA, 22 nt, Homo sapiens
ugcuguuagcccuagccccgca

SEQ ID NO: 39684 - RNA, 22 nt, Homo sapiens
gcugaggcuguggggcuggagu

SEQ ID NO: 39685 - RNA, 23 nt, Homo sapiens
aacaggugcucaaauaagacuug

SEQ ID NO: 39686 - RNA, 22 nt, Homo sapiens
ggagauggagccagggcccuaa

SEQ ID NO: 39687 - RNA, 23 nt, Homo sapiens
cuaacugcacuagaugcaccuua

SEQ ID NO: 39688 - RNA, 22 nt, Homo sapiens
acggaagggcagagagggccag

SEQ ID NO: 39689 - RNA, 23 nt, Homo sapiens
cacugugggcccucuccgcacca

SEQ ID NO: 39690 - RNA, 23 nt, Homo sapiens
acaacaaaaucacuagucuucca

SEQ ID NO: 39691 - RNA, 24 nt, Homo sapiens
cacccccagagccucagcucccca

SEQ ID NO: 39692 - RNA, 21 nt, Homo sapiens
aucugcacugucagcacuuua

SEQ ID NO: 39693 - RNA, 20 nt, Homo sapiens
uccgccugucugaacaguga

SEQ ID NO: 39694 - RNA, 24 nt, Homo sapiens
gaagucacucccaggcagcugcaa

SEQ ID NO: 39695 - RNA, 21 nt, Homo sapiens
gggcaucugggacgcgcagga

SEQ ID NO: 39696 - RNA, 23 nt, Homo sapiens
cccaacagacauggcgguacuca

SEQ ID NO: 39697 - RNA, 20 nt, Homo sapiens
acagcaaggagggcaggagg

SEQ ID NO: 39698 - RNA, 22 nt, Homo sapiens
ucaacaucagucugauaagcua

SEQ ID NO: 39699 - RNA, 22 nt, Homo sapiens
uccaggagcucacaaucuagug

SEQ ID NO: 39700 - RNA, 19 nt, Homo sapiens
gccucagaggcagcugcuu

SEQ ID NO: 39701 - RNA, 21 nt, Homo sapiens
cacaacccuaguggcgccauu

SEQ ID NO: 39702 - RNA, 23 nt, Homo sapiens
cccagcuagauuguaagcuccuu

SEQ ID NO: 39703 - RNA, 23 nt, Homo sapiens
agggauuccugggaaaacuggac

SEQ ID NO: 39704 - RNA, 22 nt, Homo sapiens
gaagaaaggcaucauauaggag

SEQ ID NO: 39705 - RNA, 21 nt, Homo sapiens
gaccaagaaauagccuuucaa

SEQ ID NO: 39706 - RNA, 22 nt, Homo sapiens
gagauuggccauguaauacuca

SEQ ID NO: 39707 - RNA, 23 nt, Homo sapiens
caugagugacgcccucuggagua

SEQ ID NO: 39708 - RNA, 23 nt, Homo sapiens
acacacucacacacacacacuca

SEQ ID NO: 39709 - RNA, 23 nt, Homo sapiens
cuccagccccuccagggcuuccu

SEQ ID NO: 39710 - RNA, 22 nt, Homo sapiens
ucacauuugccugcagagauuu

SEQ ID NO: 39711 - RNA, 22 nt, Homo sapiens
gaauucaucacggccagccucu

SEQ ID NO: 39712 - RNA, 22 nt, Homo sapiens
aagagggagacccaggcucgga

SEQ ID NO: 39713 - RNA, 24 nt, Homo sapiens
acugggcacaaacauguccagguc

SEQ ID NO: 39714 - RNA, 21 nt, Homo sapiens
ucgacugccacucuuacuaga

SEQ ID NO: 39715 - RNA, 20 nt, Homo sapiens
ugucuccacagggcucuuua

SEQ ID NO: 39716 - RNA, 22 nt, Homo sapiens
agaaagcgcuuuccuuuguaga

SEQ ID NO: 39717 - RNA, 21 nt, Homo sapiens
uagaaaggcuaggaccaaacc

SEQ ID NO: 39718 - RNA, 22 nt, Homo sapiens
acuucaaggaucuuaaacuuug

SEQ ID NO: 39719 - RNA, 19 nt, Homo sapiens
gcucuaagaaagccacacu

SEQ ID NO: 39720 - RNA, 23 nt, Homo sapiens
accacaggagucugagcauuuga

SEQ ID NO: 39721 - RNA, 22 nt, Homo sapiens
cagaagugggccgggcacaggg

SEQ ID NO: 39722 - RNA, 23 nt, Homo sapiens
cuaccugcacuauaagcacuuua

SEQ ID NO: 39723 - RNA, 21 nt, Homo sapiens
ucaaucacagauagcaccccu

SEQ ID NO: 39724 - RNA, 25 nt, Homo sapiens
aggccgccacccgcccgcgaucccu

SEQ ID NO: 39725 - RNA, 22 nt, Homo sapiens
cagaagugggccgggcacaggg

SEQ ID NO: 39726 - RNA, 23 nt, Homo sapiens
ucaguuuugcauagauuugcaca

SEQ ID NO: 39727 - RNA, 23 nt, Homo sapiens
ucaguuuugcauggauuugcaca

SEQ ID NO: 39728 - RNA, 20 nt, Homo sapiens
acauuacuguuaucaaaaca

SEQ ID NO: 39729 - RNA, 23 nt, Homo sapiens
cuaccugcacuauaagcacuuua

SEQ ID NO: 39730 - RNA, 21 nt, Homo sapiens
aacggaaccacuagugacuug

SEQ ID NO: 39731 - RNA, 22 nt, Homo sapiens
accagcuaacaauacacugcca

SEQ ID NO: 39732 - RNA, 22 nt, Homo sapiens
cacuuaucagguuguauuauaa

SEQ ID NO: 39733 - RNA, 22 nt, Homo sapiens
cacuuagcagguuguauuauau

SEQ ID NO: 39734 - RNA, 21 nt, Homo sapiens
uucacuccaaaaggugcaaaa

SEQ ID NO: 39735 - RNA, 22 nt, Homo sapiens
agcaaaauccgcaaguacuuuu

SEQ ID NO: 39736 - RNA, 23 nt, Homo sapiens
agacaaggcccacccgugcaaac

SEQ ID NO: 39737 - RNA, 22 nt, Homo sapiens
gauuccaauuuuuccacaucuu

SEQ ID NO: 39738 - RNA, 23 nt, Homo sapiens
gggagugaagacacggagccaga

SEQ ID NO: 39739 - RNA, 23 nt, Homo sapiens
aggaacagcagcagcccgggccg

SEQ ID NO: 39740 - RNA, 22 nt, Homo sapiens
cggugagcacccggccccugcg

SEQ ID NO: 39741 - RNA, 23 nt, Homo sapiens
cccaacagacauggcgguacuca

SEQ ID NO: 39742 - RNA, 23 nt, Homo sapiens
ccacccaaugaccuacuccaaga

SEQ ID NO: 39743 - RNA, 24 nt, Homo sapiens
cagaaagugcuuucuuuuggagaa

SEQ ID NO: 39744 - RNA, 22 nt, Homo sapiens
aacacucuaaaaggaggcacuu

SEQ ID NO: 39745 - RNA, 23 nt, Homo sapiens
cuccagccccuccagggcuuccu

SEQ ID NO: 39746 - RNA, 21 nt, Homo sapiens
caucaccuuccuucuccucca

SEQ ID NO: 39747 - RNA, 21 nt, Homo sapiens
cggcucggguggcggcgacgg

SEQ ID NO: 39748 - RNA, 21 nt, Homo sapiens
cggggugcacgggcggagggc

SEQ ID NO: 39749 - RNA, 21 nt, Homo sapiens
acuagacugugagcuccucga

SEQ ID NO: 39750 - RNA, 22 nt, Homo sapiens
ucagaccgagacaagugcaaug

SEQ ID NO: 39751 - RNA, 19 nt, Homo sapiens
guccugaauuccgcagccu

SEQ ID NO: 39752 - RNA, 25 nt, Homo sapiens
accaacggaccuacuucccuccgcc

SEQ ID NO: 39753 - RNA, 22 nt, Homo sapiens
cacaagaucggaucuacggguu

SEQ ID NO: 39754 - RNA, 22 nt, Homo sapiens
cgcaaggucgguucuacgggug

SEQ ID NO: 39755 - RNA, 22 nt, Homo sapiens
cacaucucacuguagccucaaa

SEQ ID NO: 39756 - RNA, 22 nt, Homo sapiens
acccuuaucaguucuccgucca

SEQ ID NO: 39757 - RNA, 23 nt, Homo sapiens
cccaacagacauggcgguacuca

SEQ ID NO: 39758 - RNA, 21 nt, Homo sapiens
ucaaucacagauagcaccccu

SEQ ID NO: 39759 - RNA, 23 nt, Homo sapiens
acacacucacacacacacacuca

SEQ ID NO: 39760 - RNA, 23 nt, Homo sapiens
agcagcauuguacagggcuauga

SEQ ID NO: 39761 - RNA, 21 nt, Homo sapiens
ccccucccagccucccugcca

SEQ ID NO: 39762 - RNA, 18 nt, Homo sapiens
ugguggcagaggugggau

SEQ ID NO: 39763 - RNA, 22 nt, Homo sapiens
cuaccauaggguaaaaccacug

SEQ ID NO: 39764 - RNA, 22 nt, Homo sapiens
ucaggaacugccuuucucucca

SEQ ID NO: 39765 - RNA, 22 nt, Homo sapiens
cggugagcacccggccccugcg

SEQ ID NO: 39766 - RNA, 22 nt, Homo sapiens
acaguucuucaacuggcagcuu

SEQ ID NO: 39767 - RNA, 21 nt, Homo sapiens
aucugcacugucagcacuuua

SEQ ID NO: 39768 - RNA, 23 nt, Homo sapiens
gcuuugacaauaucauugcacug

SEQ ID NO: 39769 - RNA, 22 nt, Homo sapiens
gagauuggccauguaauacuca

SEQ ID NO: 39770 - RNA, 22 nt, Homo sapiens
ugcaagccuugggugugggagg

SEQ ID NO: 39771 - RNA, 22 nt, Homo sapiens
aguccagauucugugcccacca

SEQ ID NO: 39772 - RNA, 21 nt, Homo sapiens
cagguaccaauauuuuaucua

SEQ ID NO: 39773 - RNA, 19 nt, Homo sapiens
agaaaccccagcagagaca

SEQ ID NO: 39774 - RNA, 19 nt, Homo sapiens
gccucagaggcagcugcuu

SEQ ID NO: 39775 - RNA, 22 nt, Homo sapiens
gcacauguucugcggcccacca

SEQ ID NO: 39776 - RNA, 23 nt, Homo sapiens
uguaggcuggggauaaaugaaua

SEQ ID NO: 39777 - RNA, 21 nt, Homo sapiens
aagggucaguaagcacccgcg

SEQ ID NO: 39778 - RNA, 20 nt, Homo sapiens
uacugcuuccacagcucccc

SEQ ID NO: 39779 - RNA, 21 nt, Homo sapiens
agaaguagaccauguguccua

SEQ ID NO: 39780 - RNA, 21 nt, Homo sapiens
auaauggagaccaggccacga

SEQ ID NO: 39781 - RNA, 17 nt, Homo sapiens
gggagaggaggaggcga

SEQ ID NO: 39782 - RNA, 23 nt, Homo sapiens
gggagugaagacacggagccaga

SEQ ID NO: 39783 - RNA, 22 nt, Homo sapiens
ugagccacugugccuggccuga

SEQ ID NO: 39784 - RNA, 21 nt, Homo sapiens
ucaaucacagauagcaccccu

SEQ ID NO: 39785 - RNA, 23 nt, Homo sapiens
aaagucucgcucucugccccuca

SEQ ID NO: 39786 - RNA, 20 nt, Homo sapiens
guuugauaaacugacacaac

SEQ ID NO: 39787 - RNA, 24 nt, Homo sapiens
acgcgcaggccagagacccaggca

SEQ ID NO: 39788 - RNA, 23 nt, Homo sapiens
cacugugggcccucuccgcacca

SEQ ID NO: 39789 - RNA, 22 nt, Homo sapiens
ugcuguuagcccuagccccgca

SEQ ID NO: 39790 - RNA, 20 nt, Homo sapiens
aguacaucaucuauacugua

SEQ ID NO: 39791 - RNA, 21 nt, Homo sapiens
cggggugcacgggcggagggc

SEQ ID NO: 39792 - RNA, 21 nt, Homo sapiens
acuagacugugagcuccucga

SEQ ID NO: 39793 - RNA, 23 nt, Homo sapiens
aggaacagcagcagcccgggccg

SEQ ID NO: 39794 - RNA, 22 nt, Homo sapiens
ugcuguuagcccuagccccgca

SEQ ID NO: 39795 - RNA, 23 nt, Homo sapiens
ccgcuugagcuaacuccgacccg

SEQ ID NO: 39796 - RNA, 23 nt, Homo sapiens
ggaagccaucaagucgcugcagg

SEQ ID NO: 39797 - RNA, 23 nt, Homo sapiens
cacaaauucgguucuacagggua

SEQ ID NO: 39798 - RNA, 21 nt, Homo sapiens
ccaaccaaugaaagaaugcuu

SEQ ID NO: 39799 - RNA, 22 nt, Homo sapiens
uccacauggaguugcuguuaca

SEQ ID NO: 39800 - RNA, 22 nt, Homo sapiens
uccacauggaguugcuguuaca

SEQ ID NO: 39801 - RNA, 21 nt, Homo sapiens
acaugguuagaucaagcacaa

SEQ ID NO: 39802 - RNA, 21 nt, Homo sapiens
ugcaugacggccugcaagaca

SEQ ID NO: 39803 - RNA, 21 nt, Homo sapiens
uugucuaaccagucaccuguu

SEQ ID NO: 39804 - RNA, 22 nt, Homo sapiens
gguucaguuguucaaccaguua

SEQ ID NO: 39805 - RNA, 22 nt, Homo sapiens
ccaucuuuaccagacaguguua

SEQ ID NO: 39806 - RNA, 22 nt, Homo sapiens
uagucaagugaagcagugggag

SEQ ID NO: 39807 - RNA, 23 nt, Homo sapiens
augcaaaguugcucggguaaccu

SEQ ID NO: 39808 - RNA, 21 nt, Homo sapiens
guccugagagcgcugccuccu

SEQ ID NO: 39809 - RNA, 22 nt, Homo sapiens
ucaguggcucagguucguugca

SEQ ID NO: 39810 - RNA, 21 nt, Homo sapiens
gagcugcauccuggcuccggg

SEQ ID NO: 39811 - RNA, 22 nt, Homo sapiens
uccggggacgaacgggacgggu

SEQ ID NO: 39812 - RNA, 17 nt, Homo sapiens
gggagaggaggaggcga

SEQ ID NO: 39813 - RNA, 22 nt, Homo sapiens
ucaggaacugccuuucucucca

SEQ ID NO: 39814 - RNA, 21 nt, Homo sapiens
gaccaaucgccguccccgccg

SEQ ID NO: 39815 - RNA, 22 nt, Homo sapiens
ucagaccgagacaagugcaaug

SEQ ID NO: 39816 - RNA, 23 nt, Homo sapiens
aaagucucgcucucugccccuca

SEQ ID NO: 39817 - RNA, 19 nt, Homo sapiens
auuuugguacagcagcuca

SEQ ID NO: 39818 - RNA, 22 nt, Homo sapiens
gcggucccgcggcgccccgccu

SEQ ID NO: 39819 - RNA, 22 nt, Homo sapiens
ugcuguuagcccuagccccgca

SEQ ID NO: 39820 - RNA, 22 nt, Homo sapiens
aacuauacaaccuacuaccuca

SEQ ID NO: 39821 - RNA, 22 nt, Homo sapiens
aaccacacaaccuacuaccuca

SEQ ID NO: 39822 - RNA, 22 nt, Homo sapiens
aaccauacaaccuacuaccuca

SEQ ID NO: 39823 - RNA, 22 nt, Homo sapiens
aacuaugcaaccuacuaccucu

SEQ ID NO: 39824 - RNA, 22 nt, Homo sapiens
aacuauacaaccuccuaccuca

SEQ ID NO: 39825 - RNA, 22 nt, Homo sapiens
aacuauacaaucuacuaccuca

SEQ ID NO: 39826 - RNA, 22 nt, Homo sapiens
aacuguacaaacuacuaccuca

SEQ ID NO: 39827 - RNA, 22 nt, Homo sapiens
aacagcacaaacuacuaccuca

SEQ ID NO: 39828 - RNA, 22 nt, Homo sapiens
ccggcugcaacacaagacacga

SEQ ID NO: 39829 - RNA, 22 nt, Homo sapiens
aagcgguuuaccaucccacaua

SEQ ID NO: 39830 - RNA, 21 nt, Homo sapiens
ccuacguuccauagucuacca

SEQ ID NO: 39831 - RNA, 22 nt, Homo sapiens
aguccagauucugugcccacca

SEQ ID NO: 39832 - RNA, 22 nt, Homo sapiens
gcacauguucugcggcccacca

SEQ ID NO: 39833 - RNA, 20 nt, Homo sapiens
uccccacagacccagagccg

SEQ ID NO: 39834 - RNA, 22 nt, Homo sapiens
aacaauacaacuuacuaccuca

SEQ ID NO: 39835 - RNA, 21 nt, Homo sapiens
auaauggagaccaggccacga

SEQ ID NO: 39836 - RNA, 22 nt, Homo sapiens
caaacaccauugucacacucca

SEQ ID NO: 39837 - RNA, 17 nt, Homo sapiens
gggagaggaggaggcga

SEQ ID NO: 39838 - RNA, 21 nt, Homo sapiens
uuuagcauaaguaugucccaa

SEQ ID NO: 39839 - RNA, 22 nt, Homo sapiens
acggaagggcagagagggccag

SEQ ID NO: 39840 - RNA, 21 nt, Homo sapiens
aagacgggaggagaggaguga

SEQ ID NO: 39841 - RNA, 21 nt, Homo sapiens
guaaugggaccuuccucuuug

SEQ ID NO: 39842 - RNA, 21 nt, Homo sapiens
acuagcuuauacauaaaauua

SEQ ID NO: 39843 - RNA, 21 nt, Homo sapiens
gaaggaagugagugcagccac

SEQ ID NO: 39844 - RNA, 22 nt, Homo sapiens
ccucaggcacggccgggccacc

SEQ ID NO: 39845 - RNA, 21 nt, Homo sapiens
ggggagcgggggcccugccuu

SEQ ID NO: 39846 - RNA, 21 nt, Homo sapiens
cugaggagagaggaggugggg

SEQ ID NO: 39847 - RNA, 21 nt, Homo sapiens
agcgccuuuggcagcuagagu

SEQ ID NO: 39848 - RNA, 18 nt, Homo sapiens
ugguggcagaggugggau

SEQ ID NO: 39849 - RNA, 22 nt, Homo sapiens
agcccaaaaggagaauucuuug

SEQ ID NO: 39850 - RNA, 22 nt, Homo sapiens
accagcuaacaauacacugcca

SEQ ID NO: 39851 - RNA, 23 nt, Homo sapiens
ucaccaaaacauggaagcacuua

SEQ ID NO: 39852 - RNA, 22 nt, Homo sapiens
agcugaguguaggauguuuaca

SEQ ID NO: 39853 - RNA, 23 nt, Homo sapiens
ucucugcaggccgugugcuuugc

SEQ ID NO: 39854 - RNA, 21 nt, Homo sapiens
gaccaagaaauagccuuucaa

SEQ ID NO: 39855 - RNA, 22 nt, Homo sapiens
gagauuggccauguaauacuca

SEQ ID NO: 39856 - RNA, 22 nt, Homo sapiens
aacccucuaaaaggaagcacuu

SEQ ID NO: 39857 - RNA, 22 nt, Homo sapiens
ugcaagccuugggugugggagg

SEQ ID NO: 39858 - RNA, 21 nt, Homo sapiens
caucaccuuccuucuccucca

SEQ ID NO: 39859 - RNA, 21 nt, Homo sapiens
cugaggagagaggaggugggg

SEQ ID NO: 39860 - RNA, 22 nt, Homo sapiens
uccggggacgaacgggacgggu

SEQ ID NO: 39861 - RNA, 21 nt, Homo sapiens
gggcaucugggacgcgcagga

SEQ ID NO: 39862 - RNA, 22 nt, Homo sapiens
ucaggaacugccuuucucucca

SEQ ID NO: 39863 - RNA, 22 nt, Homo sapiens
aacacucuaaagggaugcacga

SEQ ID NO: 39864 - RNA, 22 nt, Homo sapiens
cucagagcagacgugguucuca

SEQ ID NO: 39865 - RNA, 24 nt, Homo sapiens
acgcgcaggccagagacccaggca

SEQ ID NO: 39866 - RNA, 22 nt, Homo sapiens
caaacaccauugucacacucca

SEQ ID NO: 39867 - RNA, 22 nt, Homo sapiens
ccaucuuuaccagacaguguua

SEQ ID NO: 39868 - RNA, 22 nt, Homo sapiens
acaucguuaccagacaguguua

SEQ ID NO: 39869 - RNA, 22 nt, Homo sapiens
cagacuccgguggaaugaagga

SEQ ID NO: 39870 - RNA, 21 nt, Homo sapiens
uggaaaccaagagugggucgc

SEQ ID NO: 39871 - RNA, 21 nt, Homo sapiens
cugaaaccaaguaugggucgc

SEQ ID NO: 39872 - RNA, 23 nt, Homo sapiens
aggagaaggcaccaugggauuua

SEQ ID NO: 39873 - RNA, 23 nt, Homo sapiens
ccuagagagggugagaaccugcc

SEQ ID NO: 39874 - RNA, 21 nt, Homo sapiens
ugacugacagcuuuuugagua

SEQ ID NO: 39875 - RNA, 21 nt, Homo sapiens
ugacugacagcuuuuugagua

SEQ ID NO: 39876 - RNA, 23 nt, Homo sapiens
agcagcauuguacagggcuauga

SEQ ID NO: 39877 - RNA, 19 nt, Homo sapiens
cagcaucagcagcaucauc

SEQ ID NO: 39878 - RNA, 22 nt, Homo sapiens
cacaaaccauuaugugcugcua

SEQ ID NO: 39879 - RNA, 23 nt, Homo sapiens
cuaucugcacuagaugcaccuua

SEQ ID NO: 39880 - RNA, 22 nt, Homo sapiens
cagaagugggccgggcacaggg

SEQ ID NO: 39881 - RNA, 22 nt, Homo sapiens
ugagccacugugccuggccuga

SEQ ID NO: 39882 - RNA, 23 nt, Homo sapiens
gaacagguagucugaacacuggg

SEQ ID NO: 39883 - RNA, 23 nt, Homo sapiens
gaacagauagucuaaacacuggg

SEQ ID NO: 39884 - RNA, 23 nt, Homo sapiens
uccaucauuacccggcaguauua

SEQ ID NO: 39885 - RNA, 22 nt, Homo sapiens
cuguuccugcugaacugagcca

SEQ ID NO: 39886 - RNA, 22 nt, Homo sapiens
gaauucaucacggccagccucu

SEQ ID NO: 39887 - RNA, 23 nt, Homo sapiens
gggcucuuacucccucaggcacu

SEQ ID NO: 39888 - RNA, 21 nt, Homo sapiens
gaaggaagugagugcagccac

SEQ ID NO: 39889 - RNA, 21 nt, Homo sapiens
aggagacucacaaguuccugc

SEQ ID NO: 39890 - RNA, 22 nt, Homo sapiens
ucggucccucgggccagggcag

SEQ ID NO: 39891 - RNA, 22 nt, Homo sapiens
aggucucacuuuguugcccaga

SEQ ID NO: 39892 - RNA, 20 nt, Homo sapiens
cccgccgcgucgcccugggg

SEQ ID NO: 39893 - RNA, 23 nt, Homo sapiens
cagcugcuuuugggauuccguug

SEQ ID NO: 39894 - RNA, 23 nt, Homo sapiens
agaggcaggcaugcgggcagaca

SEQ ID NO: 39895 - RNA, 21 nt, Homo sapiens
ugacugcagagcaaaagacac

SEQ ID NO: 39896 - RNA, 25 nt, Homo sapiens
aaggagcucagaagcccugcccagc

SEQ ID NO: 39897 - RNA, 22 nt, Homo sapiens
uccucuuuucuuagagacucac

SEQ ID NO: 39898 - RNA, 21 nt, Homo sapiens
guccugagagcgcugccuccu

SEQ ID NO: 39899 - RNA, 22 nt, Homo sapiens
gcugaggcuguggggcuggagu

SEQ ID NO: 39900 - RNA, 23 nt, Homo sapiens
agcagcauuguacagggcuauga

SEQ ID NO: 39901 - RNA, 20 nt, Homo sapiens
gcagcuguccgcccagacac

SEQ ID NO: 39902 - RNA, 27 nt, Homo sapiens
uuuagcacagugcuuauacaagaaggu

SEQ ID NO: 39903 - RNA, 22 nt, Homo sapiens
gcacaaaucuccagaccaccca

SEQ ID NO: 39904 - RNA, 22 nt, Homo sapiens
gaaccuaucuccccucuggacc

SEQ ID NO: 39905 - RNA, 22 nt, Homo sapiens
ucagccgcugucacacgcacag

SEQ ID NO: 39906 - RNA, 22 nt, Homo sapiens
acaaaaguugccuuugugugau

SEQ ID NO: 39907 - RNA, 21 nt, Homo sapiens
ccuucugacuccaaguccagu

SEQ ID NO: 39908 - RNA, 22 nt, Homo sapiens
gccuucugacccuaaguccagu

SEQ ID NO: 39909 - RNA, 21 nt, Homo sapiens
caucaccuuccuucuccucca

SEQ ID NO: 39910 - RNA, 22 nt, Homo sapiens
ugaauuacuuuguaaaccacca

SEQ ID NO: 39911 - RNA, 22 nt, Homo sapiens
cacucuaaagggaggcacuuug

SEQ ID NO: 39912 - RNA, 20 nt, Homo sapiens
uacugcuuccacagcucccc

SEQ ID NO: 39913 - RNA, 19 nt, Homo sapiens
ccaccucccgaguccucac

SEQ ID NO: 39914 - RNA, 22 nt, Homo sapiens
ccaguagcacggcucaguccag

SEQ ID NO: 39915 - RNA, 22 nt, Homo sapiens
ccccucuggucaaccagucaca

SEQ ID NO: 39916 - RNA, 20 nt, Homo sapiens
gcagaagcauuuccacacac

SEQ ID NO: 39917 - RNA, 25 nt, Homo sapiens
agcuagucaagcgcgguuguggggg

SEQ ID NO: 39918 - RNA, 21 nt, Homo sapiens
gcggaacuuagccacugugaa

SEQ ID NO: 39919 - RNA, 21 nt, Homo sapiens
gcagaacuuagccacugugaa

SEQ ID NO: 39920 - RNA, 22 nt, Homo sapiens
uauucaggaacauauugcaaaa

SEQ ID NO: 39921 - RNA, 22 nt, Homo sapiens
uauucaggaacauauugcaaaa

SEQ ID NO: 39922 - RNA, 21 nt, Homo sapiens
guguauaugcccauggacugc

SEQ ID NO: 39923 - RNA, 20 nt, Homo sapiens
gaaagggcuucccuuugcag

SEQ ID NO: 39924 - RNA, 20 nt, Homo sapiens
gaaagggcuucccuuugcag

SEQ ID NO: 39925 - RNA, 20 nt, Homo sapiens
gaaagggcuucccuuugcag

SEQ ID NO: 39926 - RNA, 20 nt, Homo sapiens
gaaagggcuucccuuugcag

SEQ ID NO: 39927 - RNA, 22 nt, Homo sapiens
gacaaaacccgcaaauacuuuu

SEQ ID NO: 39928 - RNA, 22 nt, Homo sapiens
acaaaauccacaauuacuuuug

SEQ ID NO: 39929 - RNA, 20 nt, Homo sapiens
agagaugagagaaacacccu

SEQ ID NO: 39930 - RNA, 23 nt, Homo sapiens
ucauacagcuagauaaccaaaga

SEQ ID NO: 39931 - RNA, 21 nt, Homo sapiens
cuggaggacggcaacagucag

SEQ ID NO: 39932 - RNA, 23 nt, Homo sapiens
ggaagccaucaagucgcugcagg

SEQ ID NO: 39933 - RNA, 20 nt, Homo sapiens
cucaaagcaaacccugcaga

SEQ ID NO: 39934 - RNA, 18 nt, Homo sapiens
gaaaugagggccagcuga

SEQ ID NO: 39935 - RNA, 18 nt, Homo sapiens
aucacauucaccucccug

SEQ ID NO: 39936 - RNA, 23 nt, Homo sapiens
gggagugaagacacggagccaga

SEQ ID NO: 39937 - RNA, 21 nt, Homo sapiens
gaccaaucgccguccccgccg

SEQ ID NO: 39938 - RNA, 22 nt, Homo sapiens
cggugagcacccggccccugcg

SEQ ID NO: 39939 - RNA, 22 nt, Homo sapiens
ucaucucgcccgcaaagaccca

SEQ ID NO: 39940 - RNA, 22 nt, Homo sapiens
acaguucuucaacuggcagcuu

SEQ ID NO: 39941 - RNA, 22 nt, Homo sapiens
auggcaguggaguuagugauug

SEQ ID NO: 39942 - RNA, 23 nt, Homo sapiens
aaagucucgcucucugccccuca

SEQ ID NO: 39943 - RNA, 22 nt, Homo sapiens
gauagagugcagaccagggucu

SEQ ID NO: 39944 - RNA, 20 nt, Homo sapiens
ugggccaccgccgagcggac

SEQ ID NO: 39945 - RNA, 22 nt, Homo sapiens
gcggucccgcggcgccccgccu

SEQ ID NO: 39946 - RNA, 21 nt, Homo sapiens
acuccaaagggaagcgccuuc

SEQ ID NO: 39947 - RNA, 21 nt, Homo sapiens
gagcugcauccuggcuccggg

SEQ ID NO: 39948 - RNA, 22 nt, Homo sapiens
gaaaagccagggucuguauaga

SEQ ID NO: 39949 - RNA, 22 nt, Homo sapiens
ggagcccgcgccccgcgccgag

SEQ ID NO: 39950 - RNA, 21 nt, Homo sapiens
gggcaucugggacgcgcagga

SEQ ID NO: 39951 - RNA, 22 nt, Homo sapiens
auaaggauuuuuaggggcauua

SEQ ID NO: 39952 - RNA, 23 nt, Homo sapiens
aaagucucgcucucugccccuca

SEQ ID NO: 39953 - RNA, 23 nt, Homo sapiens
ccacccaaugaccuacuccaaga

SEQ ID NO: 39954 - RNA, 20 nt, Homo sapiens
ugggccaccgccgagcggac

SEQ ID NO: 39955 - RNA, 22 nt, Homo sapiens
gccaccuucaaaugggaagucu

SEQ ID NO: 39956 - RNA, 21 nt, Homo sapiens
cacaacccuaguggcgccauu

SEQ ID NO: 39957 - RNA, 24 nt, Homo sapiens
acugcaggcuccagcuuccaggcu

SEQ ID NO: 39958 - RNA, 21 nt, Homo sapiens
cggggugcacgggcggagggc

SEQ ID NO: 39959 - RNA, 22 nt, Homo sapiens
cuguuccugcugaacugagcca

SEQ ID NO: 39960 - RNA, 22 nt, Homo sapiens
ucgcccucucaacccagcuuuu

SEQ ID NO: 39961 - RNA, 22 nt, Homo sapiens
uugcccucucaacccagcuuuu

SEQ ID NO: 39962 - RNA, 20 nt, Homo sapiens
acccucucaacccagcuuuu

SEQ ID NO: 39963 - RNA, 19 nt, Homo sapiens
uccucucaacccagcuuuu

SEQ ID NO: 39964 - RNA, 22 nt, Homo sapiens
uacagauggauaccgugcaauu

SEQ ID NO: 39965 - RNA, 20 nt, Homo sapiens
ugggccaccgccgagcggac

SEQ ID NO: 39966 - RNA, 25 nt, Homo sapiens
accaacggaccuacuucccuccgcc

SEQ ID NO: 39967 - RNA, 22 nt, Homo sapiens
uauccacuacaccccgcugccu

SEQ ID NO: 39968 - RNA, 21 nt, Homo sapiens
cuacgcagaaaggacacagug

SEQ ID NO: 39969 - RNA, 21 nt, Homo sapiens
cucccccacugcagcuggcac

SEQ ID NO: 39970 - RNA, 22 nt, Homo sapiens
cuggagagacaaggggaagagg

SEQ ID NO: 39971 - RNA, 18 nt, Homo sapiens
uggcgccugaacagggac

SEQ ID NO: 39972 - RNA, 21 nt, Homo sapiens
aggcggcaggcacaggacugg

SEQ ID NO: 39973 - RNA, 23 nt, Homo sapiens
cccaacagacauggcgguacuca

SEQ ID NO: 39974 - RNA, 23 nt, Homo sapiens
cgugagcuccuggaggacaggga

SEQ ID NO: 39975 - RNA, 23 nt, Homo sapiens
augcaaaguugcucggguaaccu

SEQ ID NO: 39976 - RNA, 23 nt, Homo sapiens
aaagucucgcucucugccccuca

SEQ ID NO: 39977 - RNA, 22 nt, Homo sapiens
aucgggaggggacugagccuga

SEQ ID NO: 39978 - RNA, 21 nt, Homo sapiens
cacucugaagggaagcgcuuu

SEQ ID NO: 39979 - RNA, 22 nt, Homo sapiens
uauccacuacaccccgcugccu

SEQ ID NO: 39980 - RNA, 22 nt, Homo sapiens
agccaagcucagacggauccga

SEQ ID NO: 39981 - RNA, 23 nt, Homo sapiens
gggagugaagacacggagccaga

SEQ ID NO: 39982 - RNA, 21 nt, Homo sapiens
ggaaaucccuggcaaugugau

SEQ ID NO: 39983 - RNA, 21 nt, Homo sapiens
gguaaucccuggcaaugugau

SEQ ID NO: 39984 - RNA, 22 nt, Homo sapiens
agcugaguguaggauguuuaca

SEQ ID NO: 39985 - RNA, 21 nt, Homo sapiens
ucaaucacagauagcaccccu

SEQ ID NO: 39986 - RNA, 23 nt, Homo sapiens
gggcucuuacucccucaggcacu

SEQ ID NO: 39987 - RNA, 19 nt, Homo sapiens
guccugaauuccgcagccu

SEQ ID NO: 39988 - RNA, 21 nt, Homo sapiens
gcuccaaccucagcagacugu

SEQ ID NO: 39989 - RNA, 22 nt, Homo sapiens
cacucuaaagggaggcacuuug

SEQ ID NO: 39990 - RNA, 24 nt, Homo sapiens
cacccccagagccucagcucccca

SEQ ID NO: 39991 - RNA, 21 nt, Homo sapiens
guguauaugcccauggacugc

SEQ ID NO: 39992 - RNA, 23 nt, Homo sapiens
aggaacagcagcagcccgggccg

SEQ ID NO: 39993 - RNA, 20 nt, Homo sapiens
uacugcuuccacagcucccc

SEQ ID NO: 39994 - RNA, 23 nt, Homo sapiens
ggacauuguuucagugcccaagu

SEQ ID NO: 39995 - RNA, 24 nt, Homo sapiens
acugggcacaaacauguccagguc

SEQ ID NO: 39996 - RNA, 20 nt, Homo sapiens
auuucuauaucuaucuccau

SEQ ID NO: 39997 - RNA, 17 nt, Homo sapiens
gggagaggaggaggcga

SEQ ID NO: 39998 - RNA, 22 nt, Homo sapiens
cuagggaacacagggcugguga

SEQ ID NO: 39999 - RNA, 22 nt, Homo sapiens
gagcccuggacuaggagucagc

SEQ ID NO: 40000 - RNA, 23 nt, Homo sapiens
ucauacagcuagauaaccaaaga

SEQ ID NO: 40001 - RNA, 19 nt, Homo sapiens
gggcgccugugaucccaac

SEQ ID NO: 40002 - DNA, 19 bp, Homo sapiens
gttgggattacaggcgcct

SEQ ID NO: 40003 - RNA, 19 nt, Homo sapiens
gggcgccugugaucccaac

SEQ ID NO: 40004 - DNA, 19 bp, Homo sapiens
gttgggattacaggcgcct

SEQ ID NO: 40005 - RNA, 21 nt, Homo sapiens
acuggacuuggagucagaagg

SEQ ID NO: 40006 - DNA, 21 bp, Homo sapiens
ttttctgactccaagtccagt

SEQ ID NO: 40007 - RNA, 20 nt, Homo sapiens
accaggaggcugaggccccu

SEQ ID NO: 40008 - DNA, 20 bp, Homo sapiens
ctgggcctcagcctcctggt

SEQ ID NO: 40009 - RNA, 23 nt, Homo sapiens
ucccuguccuccaggagcucacg

SEQ ID NO: 40010 - DNA, 23 bp, Homo sapiens
cgcgaactcctgggggacaggga

SEQ ID NO: 40011 - RNA, 22 nt, Homo sapiens
ucagcaaacauuuauugugugc

SEQ ID NO: 40012 - DNA, 22 bp, Homo sapiens
ttactcaataaacgtttgctga

SEQ ID NO: 40013 - RNA, 22 nt, Homo sapiens
ucagcaaacauuuauugugugc

SEQ ID NO: 40014 - DNA, 22 bp, Homo sapiens
gctcacaataattatttgctga

SEQ ID NO: 40015 - DNA, 21 bp, Artificial Sequence
  Description of Artificial Sequence: Synthetic oligonucleotide
  Description of Combined DNA/RNA Molecule: Synthetic oligonucleotide
ugcuugaagcagcucuggatt

SEQ ID NO: 40016 - DNA, 21 bp, Artificial Sequence
  Description of Artificial Sequence: Synthetic oligonucleotide
  Description of Combined DNA/RNA Molecule: Synthetic oligonucleotide
uccagagcugcuucaagcatt

SEQ ID NO: 40017 - RNA, 19 nt, Homo sapiens
gggcgccugugaucccaac

SEQ ID NO: 40018 - RNA, 19 nt, Homo sapiens
guugggaucacaggcgccc

SEQ ID NO: 40019 - RNA, 19 nt, Homo sapiens
gggcgccugugaucccaac

SEQ ID NO: 40020 - RNA, 19 nt, Homo sapiens
guugggaucacaggcgccc

SEQ ID NO: 40021 - RNA, 20 nt, Homo sapiens
accaggaggcugaggccccu

SEQ ID NO: 40022 - RNA, 20 nt, Homo sapiens
aggggccucagccuccuggu

SEQ ID NO: 40023 - RNA, 23 nt, Homo sapiens
ucccuguccuccaggagcucacg

SEQ ID NO: 40024 - RNA, 23 nt, Homo sapiens
cgugagcuccuggaggacaggga

SEQ ID NO: 40025 - RNA, 22 nt, Homo sapiens
ucagcaaacauuuauugugugc

SEQ ID NO: 40026 - RNA, 22 nt, Homo sapiens
gcacacaauaaauguuugcuga

SEQ ID NO: 40027 - DNA, 21 bp, Artificial Sequence
  Description of Artificial Sequence: Synthetic oligonucleotide
  Description of Combined DNA/RNA Molecule: Synthetic oligonucleotide
ucucucgcgaguccacagctt

SEQ ID NO: 40028 - DNA, 21 bp, Artificial Sequence
  Description of Artificial Sequence: Synthetic oligonucleotide
  Description of Combined DNA/RNA Molecule: Synthetic oligonucleotide
gcuguggacucgcgagagatt

SEQ ID NO: 40029 - RNA, 19 nt, Homo sapiens
guugggaucacaggcgccc

SEQ ID NO: 40030 - RNA, 19 nt, Homo sapiens
guucggaacacuggccccc

SEQ ID NO: 40031 - RNA, 19 nt, Homo sapiens
gaucaguugggccccaggc

SEQ ID NO: 40032 - RNA, 23 nt, Homo sapiens
cgugagcuccuggaggacaggga

SEQ ID NO: 40033 - RNA, 22 nt, Homo sapiens
gcacacaauaaauguuugcuga

SEQ ID NO: 40034 - DNA, 20 bp, Homo sapiens
catggatagtgggatgtcac

SEQ ID NO: 40035 - DNA, 20 bp, Homo sapiens
ctacttccacagtgactctg

SEQ ID NO: 40036 - DNA, 20 bp, Homo sapiens
gcgaggttgtcactcactca

SEQ ID NO: 40037 - DNA, 19 bp, Homo sapiens
gatggacatggcaccacat

SEQ ID NO: 40038 - DNA, 22 bp, Homo sapiens
gggaagaacaaaaattttccaa

SEQ ID NO: 40039 - DNA, 20 bp, Homo sapiens
gtgatggcggctcactaaat

SEQ ID NO: 40040 - DNA, 20 bp, Homo sapiens
ccatttagggcatttggaga

SEQ ID NO: 40041 - DNA, 20 bp, Homo sapiens
tggccttaatcggtggtaag

SEQ ID NO: 40042 - DNA, 20 bp, Homo sapiens
gactccagacgcaagctacc

SEQ ID NO: 40043 - DNA, 20 bp, Homo sapiens
gcactcactgggttccgtat

SEQ ID NO: 40044 - DNA, 20 bp, Homo sapiens
tttcgtcccttgtttggttc

SEQ ID NO: 40045 - DNA, 20 bp, Homo sapiens
agtcgcatagagggtgctgt

SEQ ID NO: 40046 - DNA, 20 bp, Homo sapiens
ttgccagtaaagcagtggtg

SEQ ID NO: 40047 - DNA, 20 bp, Homo sapiens
tatgaggggcaaaaggaatg

SEQ ID NO: 40048 - DNA, 20 bp, Homo sapiens
cgtccatgaaatccgaaact

SEQ ID NO: 40049 - DNA, 20 bp, Homo sapiens
ttctgtacagctccccgagt

SEQ ID NO: 40050 - DNA, 20 bp, Homo sapiens
tagagaaacgggtgggagtg

SEQ ID NO: 40051 - DNA, 20 bp, Homo sapiens
ccattccagatgcccataga

SEQ ID NO: 40052 - DNA, 22 bp, Homo sapiens
tagaagatctccctttcctcca

SEQ ID NO: 40053 - DNA, 20 bp, Homo sapiens
gatgggatctccctctgtca

SEQ ID NO: 40054 - DNA, 20 bp, Homo sapiens
tactagcggttttacgggcg

SEQ ID NO: 40055 - DNA, 24 bp, Homo sapiens
tcgaacaggaggagcagagagcga

SEQ ID NO: 40056 - DNA, 20 bp, Homo sapiens
tctcagtctcacagccttgc

SEQ ID NO: 40057 - DNA, 22 bp, Homo sapiens
tgaggtgtctgatgaggtgtct

SEQ ID NO: 40058 - DNA, 20 bp, Homo sapiens
tagagaaacgggtgggagtg

SEQ ID NO: 40059 - DNA, 20 bp, Homo sapiens
ccattccagatgcccataga

SEQ ID NO: 40060 - DNA, 20 bp, Homo sapiens
agcaatcggaacgatcaact

SEQ ID NO: 40061 - DNA, 20 bp, Homo sapiens
caatcagccaatccgagagt

SEQ ID NO: 40062 - DNA, 20 bp, Homo sapiens
ccaatcaagagcttggcgta

SEQ ID NO: 40063 - DNA, 20 bp, Homo sapiens
cctccctatgaacccagcag

SEQ ID NO: 40064 - DNA, 20 bp, Homo sapiens
ctagcaagattccggtacgc

SEQ ID NO: 40065 - DNA, 20 bp, Homo sapiens
ggggacaaaaaggtgaggtt

SEQ ID NO: 40066 - DNA, 22 bp, Homo sapiens
tagaagatctccctttcctcca

SEQ ID NO: 40067 - DNA, 20 bp, Homo sapiens
gatgggatctccctctgtca

SEQ ID NO: 40068 - DNA, 30 bp, Homo sapiens
ggggaaaatccaccagagttctgttaagtg

SEQ ID NO: 40069 - DNA, 22 bp, Homo sapiens
ccccttcaatcttaagcaggat

SEQ ID NO: 40070 - DNA, 31 bp, Homo sapiens
gcaggatattctaggatctctcagtctcaca

SEQ ID NO: 40071 - DNA, 30 bp, Homo sapiens
ttctaggatctctcagtctcacagccttgc

SEQ ID NO: 40072 - DNA, 30 bp, Homo sapiens
ggcaaggctgtgagactgagagatcctaga

SEQ ID NO: 40073 - DNA, 20 bp, Homo sapiens
tctcagtctcacagccttgc

SEQ ID NO: 40074 - DNA, 27 bp, Homo sapiens
gttattggtgggcaaggctgtgagact

SEQ ID NO: 40075 - DNA, 20 bp, Homo sapiens
cccagctgtgagtagccatt

SEQ ID NO: 40076 - DNA, 30 bp, Homo sapiens
tagccattcaattctggtgctgtggtaact

SEQ ID NO: 40077 - DNA, 20 bp, Homo sapiens
ttcaattctggtgctgtggt

SEQ ID NO: 40078 - DNA, 30 bp, Homo sapiens
ttctggtgctgtggtaactgagttcaaaaa

SEQ ID NO: 40079 - DNA, 30 bp, Homo sapiens
cccgtaaaatgaaagacacctcatcagaca

SEQ ID NO: 40080 - DNA, 30 bp, Homo sapiens
aagacacctcatcagacacctcactggatt

SEQ ID NO: 40081 - DNA, 30 bp, Homo sapiens
gtgaggctccaaggagcacacatattgtta

SEQ ID NO: 40082 - DNA, 30 bp, Homo sapiens
aatccagtgaggtgtctgatgaggtgtctt

SEQ ID NO: 40083 - DNA, 20 bp, Homo sapiens
ggctccaaggagcacacata

SEQ ID NO: 40084 - DNA, 30 bp, Homo sapiens
tattgttaggctcagttcgattccctccag

SEQ ID NO: 40085 - DNA, 21 bp, Homo sapiens
tgttaggctcagttcgattcc

SEQ ID NO: 40086 - DNA, 30 bp, Homo sapiens
ctggagggaatcgaactgagcctaacaata

SEQ ID NO: 40087 - DNA, 20 bp, Homo sapiens
ctggagggaatcgaactgag

SEQ ID NO: 40088 - DNA, 20 bp, Homo sapiens
cagttccttatcccggagac

SEQ ID NO: 40089 - DNA, 20 bp, Homo sapiens
cccggagacaacgtacagat

SEQ ID NO: 40090 - DNA, 20 bp, Homo sapiens
gttgtctccgggataaggaa

SEQ ID NO: 40091 - DNA, 30 bp, Homo sapiens
tattttgtagagaaacgggtgggagtggtc

SEQ ID NO: 40092 - DNA, 30 bp, Homo sapiens
tagagaaacgggtgggagtggtctcgctat

SEQ ID NO: 40093 - DNA, 30 bp, Homo sapiens
ccactcccacccgtttctctacaaaataat

SEQ ID NO: 40094 - DNA, 30 bp, Homo sapiens
atagcgagaccactcccacccgtttctcta

SEQ ID NO: 40095 - DNA, 30 bp, Homo sapiens
gcagatattttctatgggcatctggaatgg

SEQ ID NO: 40096 - DNA, 20 bp, Homo sapiens
tctatgggcatctggaatgg

SEQ ID NO: 40097 - DNA, 20 bp, Homo sapiens
ccattccagatgcccataga

SEQ ID NO: 40098 - DNA, 30 bp, Homo sapiens
gccattccagatgcccatagaaaatatctg

SEQ ID NO: 40099 - DNA, 20 bp, Homo sapiens
agcaatcggaacgatcaact

SEQ ID NO: 40100 - DNA, 30 bp, Homo sapiens
caatcggaacgatcaactgtaccctcagta

SEQ ID NO: 40101 - DNA, 30 bp, Homo sapiens
tactgagggtacagttgatcgttccgattg

SEQ ID NO: 40102 - DNA, 20 bp, Homo sapiens
agttgatcgttccgattgct

SEQ ID NO: 40103 - DNA, 20 bp, Homo sapiens
cgcggtactgagggtacagt

SEQ ID NO: 40104 - DNA, 20 bp, Homo sapiens
actctcggattggctgattg

SEQ ID NO: 40105 - DNA, 29 bp, Homo sapiens
aaaaactgactcggatcaatcagccaatc

SEQ ID NO: 40106 - DNA, 20 bp, Homo sapiens
caatcagccaatccgagagt

SEQ ID NO: 40107 - DNA, 20 bp, Homo sapiens
actcggatcaatcagccaat

SEQ ID NO: 40108 - DNA, 20 bp, Homo sapiens
caattgtcgaaccgctttct

SEQ ID NO: 40109 - DNA, 30 bp, Homo sapiens
aaagaaggaccaattgtcgaaccgctttct

SEQ ID NO: 40110 - DNA, 27 bp, Homo sapiens
ggccaaaagaaggaccaattgtcgaac

SEQ ID NO: 40111 - DNA, 30 bp, Homo sapiens
accggaatcttgctaggggtaggagataca

SEQ ID NO: 40112 - DNA, 29 bp, Homo sapiens
gtttctgagagcgtaccggaatcttgcta

SEQ ID NO: 40113 - DNA, 29 bp, Homo sapiens
catctccttggatcttggttctcctggtc

SEQ ID NO: 40114 - RNA, 26 nt, Homo sapiens
ugggacagagucuugcucugucgccc

SEQ ID NO: 40115 - RNA, 25 nt, Homo sapiens
gggcgacaaagcaagacucuuucuu

SEQ ID NO: 40116 - RNA, 24 nt, Homo sapiens
cgcggccccgccggcgccccgccg

SEQ ID NO: 40117 - RNA, 22 nt, Homo sapiens
aggcggggcgccgcgggaccgc

SEQ ID NO: 40118 - RNA, 22 nt, Homo sapiens
gggggagggggggcccugccuu

SEQ ID NO: 40119 - RNA, 21 nt, Homo sapiens
aaggcagggcccccgcucccc

SEQ ID NO: 40120 - RNA, 26 nt, Homo sapiens
caggaagcuagcggcagcccgggccg

SEQ ID NO: 40121 - RNA, 23 nt, Homo sapiens
cggcccgggcugcugcuguuccu

SEQ ID NO: 40122 - RNA, 18 nt, Homo sapiens
ccgcucgcaagccccucu

SEQ ID NO: 40123 - RNA, 23 nt, Homo sapiens
ugaggggcagagagcgagacuuu

SEQ ID NO: 40124 - RNA, 29 nt, Homo sapiens
ucugacgacggggauuucuacgccccucc

SEQ ID NO: 40125 - RNA, 23 nt, Homo sapiens
ugaggggcagagagcgagacuuu

SEQ ID NO: 40126 - RNA, 25 nt, Homo sapiens
cggccucgcccucggcggccccucc

SEQ ID NO: 40127 - RNA, 23 nt, Homo sapiens
ugaggggcagagagcgagacuuu
